United States Patent 7,956,242 (PLANT QUALITY TRAITS) - sequence listing, part 2

SEQ ID NO: 3311 - DNA, 807 bp, Populus trichocarpa
  Predicted polypeptide sequence is orthologous to G12
gtatcctccccccttgttcttctccaagaaacccctcaaaatattgcctctctgctctcatcccaatcccaacgctttatttcttccatgaaaattgttcaagaattcgaaccttgaataagttttttttatcgttttatttttttgagatggaaagtggagtagacaaggatatggcaacaagaaagagaggagggatagaaagtgagaggcaatacaaggggataaggatgaggaagtggggaaaatgggtggctgagataagagagcccaacaaaaggtcaaggatttggcttggttcctactcaacaccagtagcggcggctcgtgcttatgacaccgccgtttttttatttgagagggccatcggcgaggctcaattttcctgaagttttggctgcagagggttttggtggcggtggatcatgcggggacatgtcagctgcttctataaggaaaagagcaactgaggttggagctcatgttgacgctatcgagacagcgttaaaccaccaccaccaccaccaccaccaccttcatcatgatgaccgtcaaagaaacagtaataatagtagcagtagtaatgataataatgaaacggtcgttgatagtagagagttgaagccacggccggttgacttgaataaggtgcctgacccagaggattccgatggagatgagtggaagaggagttaaccaccggtagtggtacggtgggaaggtactgttatatggctgatcaaaatcatgaagccttgtatgttggattaatcaattttaaagttagtagtagtattttacttacta

SEQ ID NO: 3312 - DNA, 772 bp, Populus trichocarpa
  Predicted polypeptide sequence is orthologous to G15
ttttttttttttttttttgctaaagaggaataaaaagtatttcctagcctaaaatgcttgattaaagactaaatttttagaagtgaccgtagtcctttaatactaagctgtggatattgtaatgtgctaaaagtgtttgattaaaacaaatttcaggtacccaagaggaagctgctgaagcttatgatattgctgcgatcaaatttcgtggggttaatgccgtgactaactttaacataacaagatatgatgttgataggatcatggccagcaacactcttctagcaggagagctagccaggagaaaccgagatacggaatctagcattgaggccattgattataactcatcaacacacgacaatggtgttctataccagtcatcgcaggaaccgccaaatgcctgtggagaatcacttgatcagaagtcgatgagttctggaaattatcgaagttcttctttctcagtggcattgcaagatcttattggtatcgatcattcagtgaactctagccagctagtggtagatgaatcagccaagctagggactcttctctctaacccctcatcgttggtgaccagtttgagcagttctagagaacctagccccgataagactgccaccactatgctcttcgctaaacctccactggcatcaaagttcgttagccctacaactagcgtcactccttggttccaagctgcccaattgcggccagcggcaatccccatgtctcacttgccagtttttgctgcatggaatgatacctg

SEQ ID NO: 3313 - DNA, 761 bp, Populus trichocarpa
  Predicted polypeptide sequence is orthologous to G15
ttttttttttttttttttctttatataagaagggccagccacttcctactatattgccaacatcatttcacagcacagaatttaatcatgagactactacttctctatcccttttctctccattttgcaaaatgttcattccaatatcgagcccaaaaggtcaatttgacaaaggttcttacacttgggttacagacaaattactggcccccacccttgtctttcattaatccccggtttcctccactaacctcctaaaaagaaaaaaacatcatgaaaattcctgccttcacccctccttttccctccttaaacagtaactcttccttttccttagttcatgcaaaaactccacatgggaaccgctaacacaaggctttaggtatcattccatgcagcaaaaactggcaagtgagccatggagattcctgctggcctcaattgggctgctgcttggatccaaggagtaacgctggttgtagggcctatgaactttgatgcccgtggaggtttagcaaagagcacaggggttccggtcttgtcagggctagcttctctagagctgctcaaactggtcaccaaagatgaggggttcgagagatgagttcctcctagcttggctgattcatctaccactggctggctagagttcactgaatgatctatacccataagatcttgcactgccactgagaaagaggtgcttcgataattcccagcactcattgacttctgattaagagattctcactggcatttgg

SEQ ID NO: 3314 - DNA, 541 bp, Populus trichocarpa
  Predicted polypeptide sequence is orthologous to G15
ttttttttttttttttttcgaagcaaaagagagaaccatacatactctatttgttttgttctgtacttgagagaggcaataaagctgagtctaattatgaaaatggtcatcccatattgcacaaatcattccatagactccaatcatattgtttttaaaagcttccctccaccattaaggtcaagaaaaggaagagtttgaatatttgaagctcttgttcatgaacaaaggtcccatgcacccaagtgtcgtttaatttaactaaaagaaaacccaaataaaaaccaatctctttctttggaaacctgtttgcaaaaaaaacctttgcatcgaagtcctacgcatctgtccaagcagcaaatactggggcgtgaggcaaggatactgcaggcctcaattgggctgctgctgctgatgggatccaagagctgacatcaccatttggactagtgaacaacttggatgctgctgagggcggcattccgaagagcattggcaggcttgctctatcagggcttccttctctagagctacttaaacc

SEQ ID NO: 3315 - DNA, 839 bp, Populus trichocarpa
  Predicted polypeptide sequence is orthologous to G214, G680
ttttttttttttttttgctagaaaataattatgaactttggaggaaaagggccgtggaaagccaattcaatacttaatggttctaatggttcttaagttcttatctacgtctatttaacggagttcttaaatgcggtaatgggttcaagaaagtaaataagccaatgtcgacatatagtacacacacttacacgacaagtcttgtgggttgcagatactctaatttaaacataaaaggaatgataggcaagcgaggatattataaattacatgcaaaaacaaaggttttcccttattcaagcaagcaatatcaagtatcaaactgaagcttctccttccaaacgtaacctcttggggcctttctcctcgccctggccgctgccggttccggtcctgctttctttggcctccagtgaacaccttttgtaaggtttaaatccggttcgacgaaccttaagctttccatgtccaagcccaatcgtcagcagctcctcctccccatagttttcacatctagacaaagcatttttctccccttcttgatgaccagagcagcactcccacgttttactgttgagatttatcagtgatgcatctccatctttctcatctgcatctttcttttctccagcatcttcattctggtgcatcttactcttcagatcatgtggaggtgagaagctctggggcaatacctctctagcgaagagtgcttgaaatgccagccgcccctcttcggagacctctttccatgaatcattcatgctgctactgcttctgctgtggcgagagctagattcggaagctggatgatttgcatcatcttcttttggctcttc

SEQ ID NO: 3316 - DNA, 877 bp, Populus trichocarpa
  Predicted polypeptide sequence is orthologous to G280
ggttccttcgatctccttctcttttagaaaacatttgtctgtttccatggctaccatcactgaagattctactaacccccaacctcctcctccaccaccagcagcggcaccagctccaccccaacaacagtcacagcaacaatcctccgctccccctcagtatcctgagatgattatggcggctattgaggcattgaacgagaaagaagggtcaaacaagacatcaatttcgaaacaaattgagtcaacacaccccgatctgccacctgcacatagcacactcctctcccaccatttgaataagatgaagcaaagtggtcagcttgttttggtcaagaataactacatgaagcctgaccccaacgctcccccgaagagaggcagaggccgccctcccaagcctaagcttccaaccccaccaggaactgtttctggacctcccaggccacgtggccgccctcccaaaccaagggatcctttcgcgcctgtggcttcccctaagaagaagacgacaagtactggaactgggaggccgcgtggtcgtccacctaagaacgctagtacggcggttcccgctgcgagttctggtggtgctccacccagcggtgcgcggagaggaagggggaggccgcctaaggcgaagccagccgtggcacccgtcgctggctgagtggaattagagcaagggagagaggagagataggaatcagtttctttaatcttttttttttcctttttaactttttttcttttaggtagacaagggaactactaattgatgttgtagcttaagctttagcgttcttcttctttttttttttctaagttttgaatttagtttcaatttaaaatgtggtgagcggtattgtaatgttga

SEQ ID NO: 3317 - DNA, 858 bp, Populus trichocarpa
  Predicted polypeptide sequence is orthologous to G280
ttttttttttttttttttaccataaagcaagaaagctcaattataacaaatacaatcatccaattatacaagaagacacgacacagttgcatgcacaaaaatacacacgatgttgccatactaataacacgcaccactgttaacaactaacacacacaattgaccaattctacagacatgttgagacaacagtccgtcgactgctactaccactaatgggaggagattattaattctgaacactcacttcaggcatagttgcggccttcacctttggaggccgaccccttggccttccactacctgccgtcattggaactgctgaggttgtggtagcagttccagtggttattcctcctgtaggtcgtgccatcttgcgtggcctccctcttggctttccacttcttccagtcgcagcctttggcttcactggctttgggggtgcattgggatcctttggtggacgacccctcggtctggcagggggcaggtctgagcccggtgacaatgggtctttcggcttagggggcctaccacgaccacgcctaggaggagcattgggatctggcttcatgtagttgtttttccaaaatactaactctccggtatccttcattcgattgaggtggtgtgagaggagtgcagtgtggccagctggcaagtccccatattttgattcgatgtatttcgatattgacgtcttgttacagccattggcctcattcaatgcttcaatggctgacaaaatcatctcagggtaaggagggagtgatgggggcttattaatctcctcagctgccattaaatttccaacaaaataagagagagaaagtttgaaactttaatgtccaaactctt

SEQ ID NO: 3318 - DNA, 824 bp, Populus trichocarpa
  Predicted polypeptide sequence is orthologous to G280
ttttttttttttttttttctttttttttttttttaacagctaaaatcatccaattatacaagaagacaagacgcagttacatgcacagaaacacacaccactgttaagaactaagaacacgcacaactgcccaattctacggatatgtagaaacaacatagtccatcaattgttattaccactaatggaaggagatgcctaattctgaacactcacttcagtcatagcagcagccttcacctttggaggccgaccccttggccttccactacctgttgtcattggaactgctgaggtagctgtaggtgttccggttattcctccggtgggtcgtgccatcttgcgtggcctccctcttggctttccacttcccgcagtggtagccttcggcttcactggctttggtggtgcatttggatcctttggtggacgacccctcggtctggcgggggccaggtctgcgggtggtgcaagtggatccttgggctttgggggcctaccacgaccacgccttggaggagcattgggatctggcttcatgtagttgtttttcaaaaacattaactctccggtatccgtcattcgattgaggtggtgtgcgaggagagctgtgtggccagccggcaagttcccgtgttttgattcaatgtatttcgatattgatgtcttgttagagccacccgtctcattcaatgctgcaatggctgaccaaatcatctcagggtaaggagggagtgatggaggcttactaatctcctcagctgccattaaattcccaacaaaatcgagaaaaagtttgaaactttaaagtccacgctcttcac

SEQ ID NO: 3319 - DNA, 885 bp, Populus trichocarpa
  Predicted polypeptide sequence is orthologous to G481
ttttttttttttttttttgatgatgaaggcaccaaccaaattcaaaccacccccaacaaacaaccaaaaaccaaagccaccaaaatatatagggcactttggttccaatcagatcaactaatgcgagagattagattctacaagtgttggaactaaaaagttttaccaacgttacaacttacaattcactgaattgaccaaagcaaagccaaaccctactcgttgcctggcatggaaggaaggatcatatgctgtccctgcacttgtggactcgtatagttcatcgatccttgaaaagcaaactgtgcattttgaccaggcagacctccaactgcatcccgtttagaagatccatctccacctctagcagacccctttgcatcaccctccaactgtgacatggcagtgatccaataaaaccaatcggtgaaagagaaggaaagagaagagtcagatgattagattacaaaccaacctatatgtaaacaaaataaatcatagacaagaaaacaaactaattacctcccggtacctagccaggtacaccttaagtggctcaatataatcctcaaatcctaacgttgccattgcccacaacaaatcatccccattgatcgtcttcctcttctccttctgacacttatcactcgcctcgctggtaacaaagctaatgaactcagaaacacattcctgaacagtatccttagcatccttagcaatttttccattagccggcaacgccttcttcatgatcctacttatattagcaataggcaggtatctatcctgctctctcacccctgaccgcgggctctgctcaccaccactctcgtggctccccgccgccggactggtcggattatcggccatcttactaaaaaatct

SEQ ID NO: 3320 - DNA, 849 bp, Populus trichocarpa
  Predicted polypeptide sequence is orthologous to G481
ttttttttttttttttttattcttttttttttttttttttttttttttttttttttttttttaaaaaaatcaccgcatcattaaaagatgccccggttttatatataaaaacagagggacatacccttgccaagtacccattctaaaaatcaagacacaagttacaagttcccattatttacaatgcttcaagagtcattctacctccgatagatacccaaattatacaaatcttaccggaaacaacccaggatacaacaagtgaataaaaaccactcaagctgtcagtgcttacaccataccaatgttttatgttttgaaacactattggttctaggaactggatgaaaaattcaataccgtctaaatgacaaaattcattgtaaaaaagcacatatctactcgttgctttgcatagggaccatcatgggcggagcttgaaaatttgaatttccataactaacaccttgggagaaaaaaccttgatgaaaaatctgcgcatttggaccagggggaatatcctttttagcaaatgtatctccagtcttcgcaaatcccttggtatcaccctccatctctctgtatcgagacaggtaaatcttaagaggatcaatataatcctcaaaccctaacgtagccatagcccaaagcaaatcatcaccatttatcgtcttcctcttttctcgctgacacttatcacttgcttcgctagtgataaagctaatgaactcagaaacacattcttgaacagtctctttagcatccttagcaatctttccattagcaggtagcgctttcttcataatcctactgatatttgcgatcggtaagaacctgtcttgttcacgt

SEQ ID NO: 3321 - DNA, 704 bp, Populus trichocarpa
  Predicted polypeptide sequence is orthologous to G481
ttttttttttttttttttgatgagaaatctggaaaatttatttgccaaatatcccaatataagatgattatgatagggttgctaaaagttagcactataaaataaagacaaggaggtacgttgattgactaaaaacaagaaatggcagtaactcagcaacataaagctccatttcacctgcgcatttggaccagggtgaacatcctttttagcagatgtatctccagccttcgcagatcccttggtatcaccctccatctctctgtatcgagacaggtaaatcttaagaggatcaatataatcctcaaaccctaacgtagccatagcccaaagcaaatcatcaccatttatcgtcttcctcttttctcgctgacacttatcacttgcttcgctagtgataaagctaatgaactcagaaacacattcttgaacagtctctttagcatccttagcaatctttccattagcaggtagcgctttcttcataatcctactgatatttgcgatcggtaagaacctgtcttgttcacgtacattagaattagagcgaggactttggtctccgctctcatggcttcctccccctggactcgccggtgcctctgccgccatatcgaaaaccctaactcaccaccaataatcataattgattgatcaaaacagcaatcagaggaagataatttagagagggagagagagagaga

SEQ ID NO: 3322 - DNA, 916 bp, Populus trichocarpa
  Predicted polypeptide sequence is orthologous to G481
ttttttttttttttttttggttctaaagatttgctcgatttagaaacagatggaatgaccatcgcttcccttttttggagtacagaggttgataaagagaaagtaaggattaacgaagtgacaaatggcaaactaaggacataaattcacctttcctaaaagggaaaggtgggcaaaacctaagacccttcctcctctcttctctctttctttctttcatctgtcagaagaagctcaaattaagccgtcacttccactacttccaaaactcccagggatcttgatgccacaattatcaacaataagaacagaaaggaaaagcatgcgctaaaatcttgatctgattaacattgaaaacgaaaggaaatcaaaacccttttcattactaaaacttgacagctacgtactactgatcaaagagggaaagtaatgacgggctctctctacatgtgaaaacaatacttttatcatcgtactagtacagacattcgtttctgttcttttccatcaattagcaagcactatttcaagcaactctgtcatcagatgttccatcgcattactttcttcttgtactactgctatgcaccatcatcaatacctaccttgaattaccttgatgatgaaacccaccagcaccgtacacgtgtccttgatggtgatgacccatcatcatcatcccgccatacatcccttgccccccaccaccattaaaccctccacctccaccgccggtggaattagccccgcctccacctcccgcagcaccactcccaccagacccaccaccaggaccatccttctcccctgctggtcttcccatggaactcttctctccttccatctccctatacttctgcaagtaaatcttcaagggctccacgtactcctcgaaccctagcgtcgtcatggccca

SEQ ID NO: 3323 - DNA, 909 bp, Populus trichocarpa
  Predicted polypeptide sequence is orthologous to G504
ttttttttttttttttttcaccatgaccaataatatatattattggaataattaagaaacttttaataaatataaactgttgtgcttatatacaaggtttaatcgtaaagcagaacaattttatatatatcactgatcaacaattttatttttctataatatcaggatcccacctcctatttttctttgcttccttaataacaatataataagagcaaacatttacagaatatatatgcaactatatataaatatctccatctatatgaattgtatctacggcctcgcttcaaattggcagctacatgtttcatttggagaaactggaggccactgaatgactctctaatctcttcctaacaatcaaaatctcaatgtacctccaatggaaagctgatacaactactaatcaatcgacgaccgtctatataaacaagtatataacttgatcactatttgaatgcttcatattatccactgggaatggattcataggtctaaatataatatatgcatagaccaatgaattaagattagtttaagagtaccagttcatgcctggaatttgatatggtggcctaaaaattccatttcccatagaccccagcattgtctgttggtgcaattgagatgtctgtggaagttgactgagaagagtaactatggaactattcccatcattccccacaacactttcatctccattaatatccccttgaaatctcttacttgatgaagggacagccatgtcctcgtcggtccaatacagtgatgggagtgttcttttgagtggaagcatgggtaggtgatctggcttggatactgaagaagccacgtgagacatagaactgctgcttctgatgccatcattgctgcttattattccctcgaataaattatggtcattgt

SEQ ID NO: 3324 - DNA, 574 bp, Populus trichocarpa
  Predicted polypeptide sequence is orthologous to G559
ttttttttttttttttttaagcttagaattttgaatcaacaaatcgccatcaaaggcccatgattgcatcaaggttctacataaactataacatgttaaatgcttaagctataaactcaatcttcaaggaaactagaatatagaacccgcctaaattaggtatgaatgtaatgtatctaaaagactggagataaaaggtaactgtcctatgtgacaacagattgtaactaggatgtaaacaacagtagacagaacatgctgtagttggtctgatgatcatgctattctcagtcctttgatgaagaggaattatcctcagatgaattatctttccggcttgaagaagccattgatcctctcatttgcaaatccccaccttgtttctgctgctgctgaagttgttgctgttgaagctgatgcagctggaactgctgctgctgctgcttctgagaatgaatttggagttgttgaaactgttgtgcagctaagaaagtatgcattgcttgattattgggatataattgctggcctcctccaaaagatgcatagtttggcacttgaccagtcagtaccc

SEQ ID NO: 3325 - DNA, 627 bp, Populus trichocarpa
  Predicted polypeptide sequence is orthologous to G559
ttttttttttttttttttagaaacagaggtgaccaagcacataaacatcaataagaacttgcatgtgtaaacacccatatcggacaggaagtagagtttgaagggttttggtgaggtacaactgaggacaaacctatgaatttcgaatcaacaaatcgccaacaaaggcccatgattgtaataaaggttctacatagactataccatattaaatactttaagcaaactagaatatagagctgcctaaaagaaatgtaaggtagaaatgtaaggtaatgtatattagaaggactggagataaaaggaagggaaaatatcctatgtgacaacagattgcaactaggatgtaaacaacagtagagaccattaagtagctgccttctctttttcaatccttcgatgaagaggaattagcctcagatccattatctttctggcttgaagaagtcaatgatcctctcattttcaaatccccaccttgttgctgctgctgttgctcctgctgctgttgaagttgttgctgctgaagctgatgtagctggaactgttgctgttgctgctgctgctgctgctgctgcttctgggaatgaatttggagctgttgaaactgttgtgcagctaagaaac

SEQ ID NO: 3326 - DNA, 330 bp, Populus trichocarpa
  Predicted polypeptide sequence is orthologous to G663
ttttttttttttttttttgaacccttgaattgatcgaagcttacttttatttatgaaagttgtttaaatattattggaaggagccaacaagaaagtggctctaagaaattacacagttacaaagctcaaatccaagccaaaaggtcatgctttctgcgcgatatatgtacatatatataaactacattatgttttgttacacaggtggtcattgattgctggtagacttccaggaagaacagcaaatgatttaaagaattattggaacacaaacctgagtaagaaggtggtttctggcaccagagaagctcaaacaaaaccagaaccaac

SEQ ID NO: 3327 - DNA, 897 bp, Populus trichocarpa
  Predicted polypeptide sequence is orthologous to G668
tttttttttttttttttgttaagattagaatatatatttatatatattctaatttacactgtctgtgtaaatttattctcgacagaggaaatatgacatattagtaattaattcacatttacactgtccgtgttcttgctctaaagggatgggaacttctaactaatatgaccactgtgaaattgtatcacttcaaggcctagagcaaaataaaaagaaccagtgattctcgaacaaggaatccctttagaaaaaattactagcatattagtctaaatcagaagagcactcaaagtagccacaacaaagaagagccctcccactagaagagattatcttcatctattgtgacttcgtttatgtaatctttcccttgcatggctccttcatcaaatagccacctctcaatcaatgacagtggcacttgagcactggaatttggcttactttcgtcttggaaaaggccagtatcaggcgacatggattgagagaaatctgaatttgaagagtcgaaagagtcaaaaccaaagagtgattcaaatgcctgtgataatccagtgccatttttgtctgctttatcaggagtcccttcactagacagtgaatcagctccagccgtatcgatgaaggaattctgagtagttgaattttttagcgactgcttaggcccacttatcatccatcctttgagcaatctggatatattttcagtgcttgatgcatagattggttctgtagctggtttttcatacccacaagagggtttcaacccggttaacaagctgcttggtttaccgggagacaaggcctcgcatagggcttgcctagccatgttgatatcagtttgaagccttctctcccattggcctctagaaatttgctgtgaacctgttgatg

SEQ ID NO: 3328 - DNA, 863 bp, Populus trichocarpa
  Predicted polypeptide sequence is orthologous to G729
ttttttttttttttttttcttccttttcttttctttttctttagctctgattttctcacctgggtacctgattctcttcaccagcatcccctcagagataataatgattcaaaatgagtagtacacagtggataacttcaatgtggcctgcccaaagtgaactccaaattaggcttcttggggcttgtccctgaaacggtcgatgagcttacatctgatattttctcatagctcaagcactttggatccatgcccttctgctcaagtggtggtaagtttccgccagaatcctttaatttcccatgcaaccaagcttccctgcttgaagagttgctccagagagcctgatagtccttgtcctggtgagcatttggtcttccctgttgcattgacatttctgaccttctaggattttcaatgtcaaataccaaatcttctgaagtatctccagatgatccattatcgaacacgtccgatagcgccgaaggagctgctgctctatcagtggtcttcacagttcgatacatctgcaaatgtgatttaacatgtgccaaggtgagatctttcacatccataagctcaagaactgacttgggtgtagcccctaaaccccaacaaagaaaagagaagaacaaggaaagaggaaaggaaaatatgagtcaaattttcttttccaagttccttttttttgttttttcagtgttattgaagatggtaaaaaaaaatgaacaggaaaggtgaaagaagaagggaaaacttcggaaacgataaaaatgagaatctagaaaagaagaaagccagaggagaaaaaagaaacaaaatgaagcatactttcatggccacccaatagctcaacagcgtga

SEQ ID NO: 3329 - DNA, 772 bp, Populus trichocarpa
  Predicted polypeptide sequence is orthologous to G729
ttttttttttttttttttattattattattatttgtccttttattctccactaaagcatgcattctgtaactaacccatggcatcaaagggtagacaagagattaataagcatggtacagcagtggtaccttgaagagttgctccagagagcctgatagtccttgtcctggtgagcatttggtcttccctgttgcattgacatttctgaccttctaggattttcaatgtcaaataccaaatcttctgaagtatctccagatgatccattatcgaacacgtccgatagcgccgaaggagctgctgctctatcagtggtcttcacagttcgatacatctgcaaatgtgatttaacatgtgccaaggtgagatctttcacatccataagctcaagaactgacttgggtgtagccctttcatggccacccaatagctcaacagcgtgaacaaagcgagcatgaagagtggtagtccaacgcatccttggtgctctcatacttcttttagctggaaacctagacatgaatcttgatctcatcgacccttgagactgatagggacttatacttgtggcactagagctattagcagccagagaagaagcctgggagcaagtattatcaaaagtttgttgagagaatggaaaaagagaaggagggttttggtagacaggaatccctctaatgggtctcaagaaaccaagctcttggctcagtccttgttgttgttgctgttgaaagagcactggatgatgattatgcaggtggttttgtt

SEQ ID NO: 3330 - DNA, 514 bp, Populus trichocarpa
  Predicted polypeptide sequence is orthologous to G860, G1760
ttttttttttttttttttggcaaaaatatctctaaatgtttcatatcattgatcacagttgacgccacatccgccagaaaagaaaagctaccagactttctatgtatttatgaacagggtttttttttagcaccatattcatggacaaagtataagactctggcaccacacctaatacttgcctctgtgacattgcaggcaattgatgggagaagaactgtctggtttgagcgccaaggatctacagaatctagaaaaccagctggagatgagtttgaaaggagttcgaatgaaaaaggcaaagcctccctgatctcaagatcactttttatatgcacatgcagcatgcacataatgctgatgcagcctttttctttttacacaggaacaaattttaactgatgaaattaaagacctgaacagaaaggttttccaagactattgacttcaataattctcgaattgattgtaaagacattctcatgttcactggctttcatcggcttcattgcag

SEQ ID NO: 3331 - DNA, 882 bp, Populus trichocarpa
  Predicted polypeptide sequence is orthologous to G860, G1760
ttttttttttttttttttcatacaagaaccaatctcaacatttcattaactcaaaaggatatacacaagtctgtctgtgcatgcgctatgcacaatgattttctattatgccaagccatgttcaatttaattttatcctgcaaccaaacacaatagtgacgtcgccatacaggaacatttacaaaattcataaacaaaattcctctgtgcaaaactgaatacacgaccatctcattaagtgttctctgtagactgtagcatgaacatgcagatttataaggcaatcacttcttcaagcagctctcatcaattctattctactccaaattattgcttgttatatgatgcacttcattttctgctcactagttgtggaaaagggaggcagcaagcttggggaaggaactgcagtgcttgaaagaatatcatcggtaaagttaattatcactgaatattctcaatagaggatctcaacaacacgtcaccgttggccttaaaataatggtgtaggctgtgtggttaaaaaaatttacagccatgttatgtttcacatcatcgatcgcggttgtagccacatctgccacgagaaaaactaatagatttatgcatccatggacaagttttctttctaacactatattcatggacaagtataaaactccggcaccatacctaacatttgccttgagatgttgcaggcaattgatgggagaagaactgtctggtttgagcatcaaagatctagaaaatctagaaaaccagctggagaagagtatgaaaggtgttcgaattaaaaaggtaaacctatactgatctcaagatcactttttgtacatgtatgcagcatgcacttgatgctaatgcagcctttttttgcacaca

SEQ ID NO: 3332 - DNA, 763 bp, Populus trichocarpa
  Predicted polypeptide sequence is orthologous to G904
ttttttttttttttttttgcccaaaaagtacgtagaggaatttatacttgcaaagaaaagaaaaaaaacatcttatcaccaatttgaaacctaatttatatcatagttaaagccttgagagaatgaatcaacaggccaaagttttgaaaaaaacagatagagcaaaccatattacctggacaagagcatttataatgacaagggggtcaaattttgagcagtaactcgcctcaatttaccatatacagcgggtgagaacatttcatagaaacaaggccaatcgccaagtctttatcttcagttaaagtgtaatgttcatccctgacaaccttaattaatgcacccataagcttctttgattgaacatctgctttcaaaactacaattcgatcttctttgagaagaatcaccacaatatttgcctccagtctctccacttgaccgatctttgagatgcttgctttgttaagaccacagcaatccgtagaaacactggctgactcatcagtgatggtgctgatctttgaagtaggaatactatcagagacagaggaagtttctgtaggagctgaaacaactggatttaaagctaaaatagagattgttgctgtttggcaacaatgattagcatcagaaatctctgagactggagatagatcataggattccttgttaattttcggggaaacgtattgagttgtcgacctaaactcaccgtcgaagcttttctttggattctacacaagtcacagggccagttagc

SEQ ID NO: 3333 - DNA, 778 bp, Populus trichocarpa
  Predicted polypeptide sequence is orthologous to G913, G1753, G2514
ttttttttttttttttttgcagatggaaagagagacgtactctggctctagctgacacatttaaatatatacaactaacaaatgtggcagcaaaatcgattcaccaaccagtttttacctttatctacacaacactccattgcctattaccccatagaaaaatctttaataaaagccaaccttttgttacatcatgggaccaaaacctctccctttgaccaaaaccaagaagcaaattctccatggagaagctgtttgggtttgctttagtggtaggaccataggctttcagcatcggaactccctggtgaatcatcagaagatagtgtgtttattcttggtgggcttactagcattcctcctgccatgtcaactagcaaattgggcatgtttaaaagttcttcctcgtcgaaaatttcctgtcctgattgaacatcagcagtgataatagatgatgagccttctgtttcaggctggcccatctcagggtttggcccactttcacgcttgggtgacctggctgatgctgcactagcagctgcagcccttatatcactaggggatgctgaggctggtgttggataggaaaggattgattccgggaaattcagtggcgtgttggtgcctttaagcgctagagcagccacatcataggcggtggctgccatctcaggagttggatacgtaccgagccatacacgcgtagttttacgtggttcccggatctcggatacccattttccactccgtaacctaacacctttaaaagtcgggtgtc

SEQ ID NO: 3334 - DNA, 936 bp, Populus trichocarpa
  Predicted polypeptide sequence is orthologous to G975, G2583
ttttttttttttttttccttgcaaatcaggcaaactggttttataaacactccacaagttatatatatctaggcttgtggcccctaatcaacacaacttgcattgagaaattgtgtagggttcaaagcaagtgattattggtttgtacaatatttccacagtcaccaatcacaagaacaaataagttccttaaaccatggagattatgaggtgggattctgtgattggcaactatacatggaggaattggacaacttatataggaagggaatggagaagggattcttatactagctagctgccatgtaggacatgcatggaacaagggtcaaggaaggtttaatgtctaaaccccacaagaaatagaggtaaattaatgtcatcaattccgattgagcagctcttctatcatttgcatagcaattctatcctcttcttccgtaccattttccggctcaatctcaaccgtcggcgatgactctgtcttcttgttgtaatttccaagctccaccttcatgacccaatttgaacttgaacgagaaccagctttcttctgccacacaccaatatgagagttatcattatcaagcctcaggcaagtgagtgaaggagaagggtctttgccgcaacactttcttagctttgagttgagaagctcagccagtgccttggcaggcaagggagagttgttatctttgccaagatttgtgtcttgatcaaggtgacttgtcgggaaattggtcttggcattctgtccattcatcaatatagctgcttgatcatacgctcttgctgctgcctcagctgtctcaaatgtccccagccacaccctcctcttcagtaatgggtggcgaatttcagacacccaagagccccactggcgttgcctgacgcctctgaatttctttgattgtaccatgtttcgggagaggcaat

SEQ ID NO: 3335 - DNA, 699 bp, Populus trichocarpa
  Predicted polypeptide sequence is orthologous to G977
ttttttttttatctccactcacactactttagattatgtatatgattagattgggaaaaataatcaagaaggtgattaattaagtagaattagcaaatagaaactgctgctgctgcattttgatgtttctttaatttcagcagaactctcatgttgaatctacataacagaactccatggatcctctatctagcaactcctctatcatttgctctatatggtgatcttcaagtgacttaaaatgttcttgatggtcatcgttccccgcttgactcccccccccaacccaattcccctcctgccatttcgagccgttttcgacagtttttccggcaatgccatggctagtgccaaaactggtgcattgtgcatcatgtgactgttttgttacatttttcttggttgcttgtagagaagtcatgtgacatttatgtagcttggctgccaaggtagctgagagaagctttgacgatgatgattggggttcgttggggttgtgagggaaatttgtacgtgcttttggcccgcacattagccttgccgcctcgtcgtatgcccgtgccgcgtcctcggccgtttcgaatgtgcctaaccatattctagtcttcaggagaggatggcgaatttctgaaacccaagaaccccagtgcctttgacggacgccacgatatcgctgttgtggtctagtcatggtgcttg

SEQ ID NO: 3336 - DNA, 922 bp, Populus trichocarpa
  Predicted polypeptide sequence is orthologous to G1020
ttttttttttttttttttctgggagaaattaaggttataatctattgattaaagagttcaataaaaagagtgatacagtgtttttcaacaaacaacagtaaagaaacagagtttccctcactgttgctaaaaaagagatctgccaaaacgtattcacatacgttaaaaagaaaaagaaaaaactaacagatcacataattaacctctctcactttttttgtgggtctttttctaatcttttctaatataaaaataaaaaaaaggccaaaattttttctaaaaaatcatgcaatctccggtgggggaggaaggttaagatcaagatcaacagatcttctcggagtcttgacatcttgatgattcaaatcaacgacagaggatgaatcagaatcactcaagaccccaccgcaagaaaaaatcaccggctggttaggatgatgatgatacccatgatcgaaaaccatccttcggtattgactcttcatcaatgcatcaaaataaaccacctgctgatgattcatcgccatcggctgaaacggcaatctaacggtggatacagcgggaccaagattaagatccaacggtgcatcactgctacaaaactccacggtactactttgactgggactctgattattaccaccaccaccaccaccaccactgttattcttgctggcagctttcttgttgctgtcgatagagagaacgtttttcttaacgttctcgcatgatggatatggaaagttagtctttgccttagagccacggaactcacgtgcggcagtatcgtaggcacgtgcagcttcctccgccgtgtcgaaagtgccaagccaaacccggctcttcttactcgggtctcttatctcggcagcgtaccttccccacggcctctttctcactcctctaaaatgcacttccttgc

SEQ ID NO: 3337 - DNA, 926 bp, Populus trichocarpa
  Predicted polypeptide sequence is orthologous to G1020
caaaccccccgaaaaataaaaataggaaacccccaacgctaaaatggctcctagagaaagatctaacaacaacaacagccccaacagccctagatcggagatccgttttagaggcgtcaggaagagatcatggggacgttatgcagctgagatcagagacccaggcaagaaaacgagggtttggctgggcacttttgatactgctgaagaggccgcccgtgcatacgatgcggctgctcgtgaattccgcggagccaaagccaaaactaatttccctacaatcggcgagcttaatcccaaccccacgcgcagtcctagccaaagcagcactgtcgagtcctcctccccaccgcccccacgcgccgcttctcctccaccaccactcgacctcactcttaacatttcccgccataaacccgaccgccagccttttcccaatggagttagttttccaggaggcgcgtggtttccattccctgctgttgcgcgtcccgttttcttcttcgacgcgtttgctcacgcgaagaatgatattcctaacaataatagtatagtgaataatattaacatgtgcaggtttgatcgaacggtgatggtgaatggaggtggggcccagagtgattcggattcatcatcagtcgtagattacgatcgtcgtcgtgatagtaagggattgtcacttgatcttgatcttaacctggccccaccaccggaagtctcatgatcttgtggtttttcatggagagatctgattttggaagtcgttttatggcttcagtgttgtttttttcctctaatttcctgggtacgacaggaagagagcaagttttagagaattagagctaattaaggaaaaaagaagaaaagaaaagcagctgacgtattttgtatatagagagaacggaaattatctaaaactatttccc

SEQ ID NO: 3338 - DNA, 805 bp, Populus trichocarpa
  Predicted polypeptide sequence is orthologous to G1047
ttttttttttttttttttaacaataggaaaacaagatagataatatagctttaaataaccgaccgagcacgagtcaactactctttttacatgagaatgaaccaaggctcaccaaaaccgccaatcattttgccctaaaagcaccctttaccaaaaatcaccgtaaaccccaccatttaagttttgcttcatagcagctttatcatttacatatatatataagactctacaaggagtgctgatcagaagactctacaaataaagcctcgttttcttcctgttttaactttcagtttcatgatttattgagtttattttatagtttatgaagtgattaatgatggagctatttgttcggtggtggtggtggtaatcatattattgcatggccacgcggacgtcaattcttggagttgcctcatcatcaaaatttggcgtatgtccgacagcttttttcggagcgtactatactcagaccggagtcggtcgtagtctgtccgtacaccatgggaatggtacaaaacaaagcgcaaccggttcgtcagttcccggttctcaatcctaagccggttcacctggttccttaggttttctacgtgcttctgctttcgcatccgtgaccgccttgccgactcccggtttgataccatccgcctgcgtttcctctcatctatgagtgaagcttgagggtttgggtcgtcggagccagagtttgagttcgagttgtcagggttttggcctgcctggttggatttatccgaaccggaactcgaaccaacaggttttggtgactgaggagagcttg

SEQ ID NO: 3339 - DNA, 866 bp, Populus trichocarpa
  Predicted polypeptide sequence is orthologous to G1108
ttttttttttttttttttggctattgggcaaactggaaagagagtgccacacagattcttaaaagagatttttgatccatgagattcataaaaagagaagaatgaaaaaaaaatttacagcataatcaaaatcgtaattatttatgtatgatattactattttgtgttatatagaggatcaaaacactgcaccagccccgttttcgacccgtctctggctagaacttaacccagagagagaacctaaaagactttcaccgacctcactcttgcaaagaggacatgatgcattgatcttcagccacttatctacacactccttgtgaaagaaatgagaacatggcagctccctcagctcgtcattgtttgcaaattttgccaaacaaatgcagcaaactgcatcttctcccgagatcactcgttccttttctgttcctgcagccacgaccccaccatcactagctcctgcactgctatcctcaccatttctatttttaattaacttaaacttgtatgttggcaaggcatcaattgattcagttgtggctccccttgtctgtgtcagatcctctctatatccaagaacggaaattatacaaggcaagcaacagcagattgttgcacacagaatgaagggcatagcgtatccgatacagctaaatgtaagaaacactatacataacctgtacaagtttggagcctcctcagcagatgagtggcctccaaatatccacacattgcccaccacaaaccaaactgcgaaaaagcaatccaaagccattttgaagtattccaccaaaaccttgagtcttgcatttagtactgcattttggctgcctctaggtgatgtagtggcagatcggcgc

SEQ ID NO: 3340 - DNA, 392 bp, Populus trichocarpa
  Predicted polypeptide sequence is orthologous to G1145
ttttttttttttttttttagagaaatatattgaccatacgaaaaagaactagctagcatgggaaaaatcccaggacactccaacagtgaaaattacatatgaaaatttctaactcaacttttcacagaatagatacaagaaagaaaaaaaactcatgatgatgagaagcaaactcacagcagtgaatgtgacaagcagctgcttctaagagtaaattatgagcgcaaaccagaaattctttgtatctacaaaacttcatttgctagaatggggctgatgttgttctgcgaagctgatatttgggctcagggagagggacacatggcaacatattctccagctcccttagtttcctcagcctttcattttcctcttccagccgagaaatttta

SEQ ID NO: 3341 - DNA, 873 bp, Populus trichocarpa
  Predicted polypeptide sequence is orthologous to G1145
ttttttttttttttttttcaggctgaaagaagctagaaaaatatattggccattcttttgaaaaatcttaggacactcggacattgaaaattacaaatggaaatttctagctaacttttcacagaatagatacaagaaaaaactcatgatgatgagaagcaaactcacagcagtaaccgtgacaaacagctgcttcttaagaggtcaaagagtaaattatgagctcaaaccagaaatgcattgtatctacaaaacttcaacactctcgtttcatttgctagaatggggctgatgtcgttctgcgaagctgatacttgggttcagggagagggatacatggcaacatattctcaagctcccttcgtttcctcagccttccattttcctcttccagccgagaaactttgttctccagctcgcttgtgtaagcctgcttccgtgctcgtgaacgggcggcagattcacggttctttatcatcctcttctgcctcctctcaactgttttctcaaacatatttggcacacctctttttcttgctggtgtctgtgtatctgataaagtccccatcaagggtggaggtaccggcacctggttttcagggtatgaaacatccatcatagaaccagcacccatgtgaagtggctgtggcataggctggcctggcatataaacccccatcatgctttgttgtggatgttgtactgtggttgtggggggggtattgcacccattgactttgttgcagaaactgttgtgctgcatttgtatcaaccaaaacaacagaaccaccatctttcttgtccacggatgcttcagctacaactcctgcttttaccaagaaatcctcccacgtcatctctccaaaagtaggc

SEQ ID NO: 3342 - DNA, 709 bp, Populus trichocarpa
  Predicted polypeptide sequence is orthologous to G1146
cgaagatctgccatcctactgaattcgacttctatttgtgtagtcacgctgggattcagggcacaagccgtccagctcattaccatgtactttgggatgagaacaagtttactgctgatgggctgcagtccctgacgaacaatctttgctacacatatgcacgatgcacgcgatctgtttccattgtgccacctgcatactatgctcatcttgctgcatttcgagctcgtttctacatggagccagagacatcagacagtgaatcaattgcaagtggcatggctggtggtcgaggaggtgctggtgggggtcctcgtccaacgcgtggacccggtgctaatgctgctgtgaggcctttacctgccttgaaggagaatgtcaagcgggttatgttctactgctaggatcgttggaaatcccttacttttcgataggcatttaaattttacgagttgaagctgttctgttcggaaagcgggggaggcccctgcttgctctgaagcagaatatcaagctggctatgctctctgctttttgtgacgtctggccagttgatatttgcttttaaattgccactgatactgtcgtgatcagaaagctgctttctgctcatgctgtgtgtatggcatcgaatatcattgaatcttaaaactcttaatcctcctctggaaactgggatttcatttttcaaaaaaaaaaaaaaaaaacc

SEQ ID NO: 3343 - DNA, 875 bp, Populus trichocarpa
  Predicted polypeptide sequence is orthologous to G1146
ttttttttttttttttttagacagcatcttaaaagtcttagaattcaaggcattcaatgtcacacaaagtttgaagaaagcgaaaaaagcaagaagttttgaacatgtaacccaacgctgacacaaccagcttgatattgcatgtaagggtaagcaggggcctcccagggatttaaacaacaatccaaaagtaagggctgtctcgaatcctaacagtagaacataacccgcttgacattctccttcaaggcaggcaggggcctcacagcagcgttggcagcaggtccgcgagtggctcgaccacctgctcctccacctcctcgtccagcagccatgccacttgtaagtgatccgctgtctgatgtctccggttccatgtagaaacgagctcggaatgcagcaagatgtgcataatatgcaggtggcacaatggaaacagaacgcgtgcatcttgcatatgtgtagcaaagattgtttgtaagagactgcaacccatcagcagtgaacttgttctcatcccaaagtacatggtaatgagctggacggcttgtaccctgaatcccagcatgactacacaaatagaagtcgaactctgttgggtgacaaatttttgagtccacgacagtgccaggcaatatattcccgctccggtcaacagcattacggtcacggtgatcatttgcgaacagccttgtgtgatgacgcttctgaaccacaacaaatgtcactggaggctggtagttgggctctaaagaagcacatgccttacgaatagcatcaagttcgtgcaacaaaacttgatagaactgcccttcactgacaccatctctgtagaatataattctctgaggcttctgccctgtggctctccggaa

SEQ ID NO: 3344 - DNA, 797 bp, Populus trichocarpa
  Predicted polypeptide sequence is orthologous to G1198
tttttttttttttttttttttaaaccagaaagactcgaaactgtagctgatttatgaactcttgaccattatacaaatttcaaggttttatggaatctctatgttatagatgacaaatataaaaacaattagaagcatacctggcgaataaatccctcaagggtacctagctttcccatggccatggccatctgacccatgtaatttgccacatttccagatggccctgaggagccaagagatccgctggacaaagtctcagagagggactgctgcaatgcctccatcccttgagataatgcatcttccgcctgttgggaggactgctgtaagttgccaatgcccaccaactgctgctctgttaaaggctccaattgattcataagaagcttgaggagctcagatgaacggaagccaccaagccacaagaaacacctctctgcaggtgtcttccacatgccagacagcaaatggaaaacatcagccttggctgcgttgctcttcagcttgaaaacttcatcatagtgagccattataccatcagtgatataccgaagttctgcatcaccagcatgagaattgacagctgatctcaactcattaatttgtcgattttgctcctccagccatcgtgcatattctacatcaaatgccatgggccccatttccactcattgaatgagtttggtctcctgagcttgatatgaagattccctgctgccgtgcccgttggagctctgtttcagttggctgagcttaagcggctactctcagctgctggaatatgctttcttcct

SEQ ID NO: 3345 - DNA, 875 bp, Populus trichocarpa
  Predicted polypeptide sequence is orthologous to G1198
ttttttttttttttttttggagtacaaacatagcctacatttcaaatgaaactttctaacacttttaactatacatcctgcaccgagtatcaacttaattacctaaatttgctgcttcagacacaaatcattacgattcatatttacatctgctttggaaaaacatataactggatcgaatacttgtccgtattacaaatgccacaagaacccgttcccctgcagagggcacaagtgctggtggggatcaatatagatatagtggttttctagggtcatacctctgctgactaggcaggttcacaaggacgagcagcccatagagaactgagagtacgaagacggtggaagtactctcctaatgcaagtaaacctcgggctgcttggcgtattgttaagatccgagacatgtggtgcagagtttgttgccgaaggtgatcagcctggttcacaaatccctcaagctcgtcagccatcttatccccataacccccatcacccattacatcagctgctatgctttgggacagagtctgctggagtttatcaattccttgagttagagcatcttcagcttgctgagaagattgacgaaggttacagacatccgcaagctgttgatcagtcaaaggctcaagttgtgacatgagaacatttagaagttctgatgggcggaatcctccgatccacagaaagaagcgttctactgatgttctccattttccagaaatcagatagaagacatcagccttcgcagcatctgttttcatgcggaaaagattgttatagtgattcaagccattctcaactaggatccggagctcaatatcagttatacgagcttgcaatgcattcctaagttcagaaatttgttt

SEQ ID NO: 3346 - DNA, 905 bp, Populus trichocarpa
  Predicted polypeptide sequence is orthologous to G1198
ttttttttttttttttttgtcgaattattgccactagatgttttataacaagaagataagcatacatctgtgtgagcaaacctggcgttacaactgcacatgaaacctataattacaccaactatggccgctatttgttttacagcaagaagataagcatacatctgtgtgagcaaatctggcgttacaactgcacatgaaaccaataattacaccaattgcgacctatccgcaccacaattaccaccgatgatgatgactaagaccaccagcggcagtccacccaatggcatgatgagaactgaaggccaagtaggagggtggtgaagtggtagatattcatgttaattttgttggggggcaacatactgctactcattcctgtggccgggccaaccagagagaactaagggctcgtagcctagagaaatagtcatgtatagctagaagagcacgggctgattgccgagttgtcaatatacggtgcatttgttctagtgtttgctgcctcagattatcagcctgacgaaggaatccctctagagttcctagctttcccatggccatggccatttgacccatatagtttgccacgttcccagaagaacctgatgagccagggttgccattagccaaggtttctgccagtgattgctgcagcgcttccatcccttgtgagagagcatcttctgcctgctgagaagattgttgcaagttgtaaatgcccattagctgttgctcagttagaggctccagttgattcacaagaagcttgaggagttcagatgagcgaaagccaccaatccacatgaaacaacgctctgctggtgtcttccacatccctgataggatgtggaaaacatcagcttttgcagcagtgcctttcagcctgaaaacatcactga

SEQ ID NO: 3347 - DNA, 905 bp, Populus trichocarpa
  Predicted polypeptide sequence is orthologous to G1421
ttttttttttttttttttagacaattatcgccatataattcactaaatatggactaattaatactccactatatacttaaactccgtagtttgactaatcaaaccaaaaacttgacataaaaaataaagggacactttaggtattccagctctatatcaggcgccctttctatccacttggcgcctttaatcacgaatcatggtatgccacatcccgatagggttgtgtcaaattacaaaagactccccaaacttccacaaaattgaggatatgtttttaacagatggcatccaccaagaaatcatcgaggtcaacgaattcttccttgtcaaagaaattccccgacaacatagaatttggcaaacttaacggcacgtcaatttcgaacccaaaagcgtcaacgtcaccgtaacccaaactatcaaacggcgataactcttcgtatgggagaacagacgtcggtgatgacatatcgtgaacaccacttaacggcgactcacatgactcgcgctgaccatcaacaaccttagccttctccgttaaaacagcgtcagacggtgtcaaatctacgtaacggaggactaatgcgggtgatgccataacgttagcagtacccctgatagacggcgactcccgtgattcacacttcacatcacttgaaccggagttaacgtgagctttctccgttataacggagttcgtaggaaagttggtaacggcgtcgggtccttttagtttcagtgcagctcgatcatatactgtagcagcttcctctgcagtgtcaaaagtgccgagccagacccgtttccgtcgagtcgggtcacggatctcggcggaccacttccccagggtctctgacggacacccctgaactttttctgacgagatacatcaggtaacggta

SEQ ID NO: 3348 - DNA, 912 bp, Populus trichocarpa
  Predicted polypeptide sequence is orthologous to G1421
gattctctctcaccctctcccctctccctcacacgcagagagagtgaagaacactgaactcgcagcaagacgttattctttttctcgtttcccactaaaagcttcacacccttttcgccgtttcaggctagccaacttcttcgtgaaatccaggagttgctgctccacaaagctagctctagctttaccttccctctttcgttactgtatttataagtacaccttccaactctcaagatccaattaatcttagtacatattaagtggcttccttcactcttcttcagtttttttcttcatctttcacttcattcatcagccagacaaagctggctagctagaccaacttgagctggtcaatacatggttttgcctctacgtcttcacccacttcttgatcacaaaacccagccctttctaccactctttcatcttctatcccccactaaatcataacccatgctgatctacaaccccaacaccatgtccgtacaatcaaaagtcaaatttactgaacacgtattcgccactaaaaagctcatcaagaaccagcagcagcagcatccttcttcaaggatccgcggccaaagacttgttagaatcatccataccgaccctgatgccactgattcctccagcgacgaaggagaagaacaagaacaggagaggaggtttgtcaggagagtgaagagacaagtgagtgaaataagattgctagagcaggagacaacagcaccagcagctccttcttcaagaacttcaaatgatgatcatcgagacccaacaagaaagagacctttcttcagactaccggtatccgacgtcactcgccggaaaaacttcaggggtgtccgtcagagaccctggggaaagtgggctgccgagatccgtgacccgacccgacggaaacgg

SEQ ID NO: 3349 - DNA, 798 bp, Populus trichocarpa
  Predicted polypeptide sequence is orthologous to G1421
gcactcacacacacacacccccccagagtgagtgaagatcactgaactgcagcaagacacaagtctttttctagtttcccgccaaaagcttaccacccttaatttgcagcttcaggctatctaacttcttgatcaaacccggagttgctggtgtcactttgtcaccttcttccaactcctcgaagtgcaagctatagcttctctttttgtctctatagttgtcactagctacttatataatccctccaacgctggagatccagttaagcttagtataaagtagcttccttcagtttttttcctccaagaaaccaataagaatcttcatccttgatcacccaaataaattaagctagctagaccctacctgagctggtcagtacatggttttgccgctatgtcttgacccacttcttaattgaatacaaaaaccaacccttggtaccacccaccatgcatcttctattccccaatgaattacaacccatgtttacctccaacgccaccatgtccgttcaaccaaaagtcaaatttactgaacatgtattcatcactagtaagctcatcgagaaccagcagctgcatccttcttcaagaacccgccaaagacttgttagaatcatccataccgaccctgatgccactgattcctccagcgatgaagaagaggaagaacaagagaggaagtatgtcaagagagtgaagagacaagtgagtgaaataagcttgttagagcaagaaacaacagcaccagcagctccttcttccacaacttcaaatgatgatcaggaaaccaga

SEQ ID NO: 3350 - DNA, 926 bp, Populus trichocarpa
  Predicted polypeptide sequence is orthologous to G1560
ttttttttttttttttttcaatacattcttcatccaagttgatcagttggttttcatttagttcttgcatgttcatagccagattgacaaattctggaacttcaaactcagaaaaaccaccgaactcccgaggttcaattttaacaaatgttcctactccctcaccatggccaaattctccaacctcaacattattacgcccttgatcaatcggtcgccttttctttttactaatctcctcttcaagctctttcatcatgtccttttgttggactagttgctgcacaaaggtgggattttgcattgctctagccaagaaactcatcatatgttgctgtttattctcattccttttaactcgttgttccataagttgaaggcaagctctagtagtctgttgttgctgtctaagcttcactagttccaccattagtacttgtttgtctcggcttaatcgatcaacttccccatccagtctaaatgttccaacttcaacacaagcctctagagcttgctgagaagtctgagtttgaggagcttttctcctcctaacagtcttgagaagatgttttttccccctgagaaatccttcattagcaaactcccatctatctggatcaacctttctaaacccatatgtgtttagctgcctaacaaagcttgagaaattgttgtgcttgaagtatctagggaggagactaatggaaaaggcttggggatcccaaacaacaaagctgttgttacctctactccaagagataatatggtttgtgcttgaatcttctattatatcataagttttagtgagaaatggaggaggacctgggtcatggagtccctccattggttgtggaatagctgtagatgccatgcctgatgagtgtgtgcttgaactaccacctgcatactcctccttgatcgctcgg

SEQ ID NO: 3351 - DNA, 946 bp, Populus trichocarpa
  Predicted polypeptide sequence is orthologous to G1594
ttttttttttttttttttgggagtagattattcattcaaactatgtaagcattaattgcgaatatacatgatgcaaaatacaattaatcttcctttcttttttatttctaaagatgaacttttcaatgccagcaatgttgcgttgcataatgtacatgaagccaacaggaatatcagtcgtcttctgtaaagaactgcccagaaagattatccataacagcaaattgcaggttctcagatggtttccagtggcgcttacgttgatttataaaccaattattaatttgcttctgatctagtcccgtcgattccgccaatgctatcttatcagcttcctggaaagatgattaagcaagcaaattatcgtcttaccagcgttgaactttggaaaacaattaaaatcctgcctgcacaaattcatagcatttacatatatatatatagctaccagcatcaaatgaaacatctacatccggcccatctgtaactcgtttataagaatcaaaagacataatgctacccttctcagtttcacacctgaaaataatttcgtgcgttctatgatatcctatgcatcggaaatcaggacttgcatatttttaaaaaaactaaaatagatgcagcctcaaggagagagagagatacacacagttggatatggccatttatagtgagcatcccaccatccaagtagggtttgcctagcttccttcggtagctttcctttcttttttttctttgagaactccagcttcagcgtaccaatatgacttccaaacctgcggagaagtttatctttaagctctcggtcttcaccacttggttgagcttcatgcatatccaactcccctccacttaactcctcatctgatgatggcgcaccttcatcagagatgcttctgatggaggcaccagtgcagagattacgaagctgcatttcaatctt

SEQ ID NO: 3352 - DNA, 647 bp, Populus trichocarpa
  Predicted polypeptide sequence is orthologous to G1635
ttttttttttttttttttggtctggcctttagtagtttcattggttcctctgagctagtgttgctgcctttttattcacgcgcaaccttaaagaagaatttctgagcatggcttcgaatctgaactgcattctttgtgcctaaatgctcttcaatccgtctccaagcacggccgtaaagctttagagcatcaaggaacttcttatgctcttcctctgtccatctctctctttgtttcgtaattgtgtaaggtttcctcgccttgggagagtaatcactcccacaagagaactgctcctttagttggtggtcagttgccttctgtagtgtagcactcggtaaaattccattgcctgctgggagaaccagatttgatcgagtccctccacactgatcctgaatagccatatctgaaaaaaccactcaaaatacccttcttaaagaaactcttacagtacccttcttgatgatatcttcctcaaactcataaactaacataataacaccaaaaaatatatctctccactttcacttattctctgacacaaactaaaaacgcaacctgacccttcaaagcaatgaagtcaaagcttaatattctaacaaaaacctaaaaagattgaagcttttggcttctaccaagctaaa

SEQ ID NO: 3353 - DNA, 696 bp, Populus trichocarpa
  Predicted polypeptide sequence is orthologous to G1655
ttttttttttttttttttctacaataacatcaaggactaatattaatagaaaaaaagagacaaattaaaaatctttaaaaaaacaaaaaaaaataattataattgacacctggcataacgaacactctaatatatttgatttctcgctctcaacttgacaagccgccatcaactcccgcgccaccgcctacttcgccgccagcggcggtgagaatttcacttagagtggtcataaccttaatttgcatctccaaagccgcaatataatcactcgcttcctctaaaagattcacaaacgaaactttccggcaaccaggaactagccggctcaaaaccttcactttcttctccaccgccggtaacttcctcctcttctctctctcctgtaaccgacgatcaccgtttaatttctgtttcttcaccttcctcactctcaacaaccgcgcgcgtttcgcgagaatcgcgcggctccactgagttcttcctctagcagccaccgcgaggactctgttagcggtttctcggacttctcgagtcctcttcccaggatgagaagatgtccggcttgaccgacggagagcttcaagaagcttcgacgaatagatccgccgctctgcttcagttcgccacctcactgttagctggtttttgctgtcattttgaatgtgactctctgtcgtttcatgagtcaatttt

SEQ ID NO: 3354 - DNA, 882 bp, Populus trichocarpa
  Predicted polypeptide sequence is orthologous to G1655
ttttttttttttttttttaaagtaaggctaaaataataataataataataaagtgctatatacaataacatcatgaattaatattaatagaaggaaaaaaaaagaagacaaatttaaaatatttaagaaaaacaaagagcaaaaagatattaattataatggacacctggcttaactaacaatctctagtacatctgtctcgtcgctctcaacttgacgagccgccaccgcctcctccgccgccagcgacggtgagaatttcactaagattggtcataaccttaatttgcatctccaaagccgcaatataatcactcgcttcctctaaaagattcacaaacgagactttcctgcatccagggactaaccggctcaaaaccttcaccttcttctccaccggtggtaacttcctcctcttctcgctccccggtgacttgcgatcacgagccaccctctgtttcttcaccttcttcactctcaacaaccgcgcgcgtttcgctagaatcgcgcggctccaccgtgtttttcctcgcgctgccaccgcgaggactctgtcagcggtttcccggacttctcgagtcttctcaccccgatgagaagttatccggcatgatcgacgcagagcctctagaagcttcgacgaatagatccgactcgctgtgtcagttcgccacctcactgtaggctggtttttggtctcgccagtgccgtcgttttgaaggtgactctctgtcgtttcatgagtcagttttctgcgtttctttctttgctggtttggttcttgttgcgatgacacgtcacagtttgattggttgcttgccattaataatgtcgtccctctttctttatcgccttttgaagattgtgacaatagagttttga

SEQ ID NO: 3355 - DNA, 671 bp, Populus trichocarpa
  Predicted polypeptide sequence is orthologous to G1655
ttttttttttttttttttggccctttaaatgctctttttgaacaactatacaactatatttctttaaaaaaggaaagcaaagctcaaaaaataaaggaaaaaaataaaaaataaaaagtaataaaaaaaaatccatgtctacaataacatcaaggactaatattaatagaaaaaaagagacaaattaaaaatctttaaaaaaacaaaaaaaaattttataattgacacctggcataacgaacactctaatatatttgacttctcgctctcaacttgacaagccgccatcaactcccgcgccaccgcctacttcgccgccagcggcggcgagaatttcacttagagtggtcataaccttaatttgcatctccaaagccgcaatataatcactcgcttcctctaaaagattcacaaacgaaactttccggcaaccaggaactagccggctcaaaaccttcactttcttctccaccgccggtaacttcctcctcttctctctctcctgtaaccgacgatcactgtttaatttctgtttcttcaccttcctcactctcaacaaccgcgcgcgtttcgcgagaatctcgcggctccactgagttcttcctctagcagccaccgcgaggactctgttagcggtttctcggacttctcgagtcctcttcccaggatga

SEQ ID NO: 3356 - DNA, 905 bp, Populus trichocarpa
  Predicted polypeptide sequence is orthologous to G1798
ttttttttttttttttttgcaacttgaaaacttataggatatatgggtacaagttgatctacgaactcatagcactctctgttcactttgttagtaatgaagtgaaactgctaaagtgttttattccttaggcatggtacccaaatctgatcaacaggaaagcctacagtcataatattatctctacaagtataccaaaacactcaaccctgacttgggcgcctagaccgttatctgcacaattcagatttatttgaggtccatatgcacgagaagtagagtttataatacggattttcactaactctatatgcctctatatcgtacacaaaaacttcaaatcccagagagaaaaataattagaaaggaaaaggtatgagaaaaggaatcactaggatcgtagaagaggataacaagagaatcccaaagtcctgcaaggatcaaggtctgtgctactatgtgtacacgtgtctgacttgtttgtttctgagagagaggcacactaatgagatcttgcatatagaaccctagggtgcaggaaccataccagcatggtacatgaaagtgaaaaggaaaaacaatgcaggaactcaaaagctttcatggaaagaggagggtggtttgataaaaaaagaagaagagagtgatacatgaattaactctacatatatatatgtataaaccatggaaggaaagctgtgcaaaagatgataccttgagcttccaaattcatagagcttccctctaggagagaagacgataacagcgacctcagcatcacaaagaactgatagttcaaaagccttcttcagcagtccatttctccgcttagagaaggtgacttgcctgcttgtagcgttctctatgcgcctcatttgagtctttcctctcaccattttctctta

SEQ ID NO: 3357 - DNA, 764 bp, Populus trichocarpa
  Predicted polypeptide sequence is orthologous to G1798
ttttttttttttttttttatccccttttttttttaggcttctctttgactttctcatatgatggttcaaacaagtttaatagcatggtagagaatcaatatatatatatatatatatatatatatatatatatataatcttccaacagatattttaactcatcgcacaatggtatagttcaactccctttttgttatgtaatatatttgggagagtttatttgactcgcgacattagctatcagatgcaaatgatttgaaaaaaagaaaaaaccattgacacttgggaagctggaactgtattgcaaatttgaaactgcaattattcaagtcttatggttttggggcaagccgtgtctctggtggtcctataaacaattctgtctccacctccgtaatttgtcggtcttctaatagttgttgcttcctggttgatgagaggtcaggttgttgcatcccacacttctcccgtaacctcgtgttttcttccaacaggattttctcctcgcctttgagcttctcaatccgctccctaaataactggttctttcttgccctaattcttgttaagcttcgccccaactggttctccaactgttgtaggtcatcagtggaacatgtttccaatccctctcctaagagcttccttttagagacttcaagaagctcgatcttcttggccagagtaaatgtatcttccttcacaggctgtatattgtcttgaaccatcttgctgctgattcctacgtccttggctctcttctg

SEQ ID NO: 3358 - DNA, 486 bp, Populus trichocarpa
  Predicted polypeptide sequence is orthologous to G1798
ggtttcaggagaagctactggcagctgaaaatgcaagactgtctgacgagtgtggtgcacagtcatggccagtctcaagggaacagagagatttaccccgtgaagatctgagagaaagcagttcaatttcggatgtggagacggaattgttcattggaccaccagaaacaagaacaaagcgcatccctccaagaaactagtggtgaatgccatcttactgcgagaccaaccttttcatattcttaagactcttgctaatgctatgttgcacctgcgcaagcaataattaaggcaatagtattattttaagagaaatatatatgctgtctgttaaaaaagctaccatgattgattgagatcaactgtaaacagagtacttaaatattgtaattaggtatatatttgacgtatcgttagacttttccttgtatgtttttctgacaataattttcttaaaattattctgtcaaaaaaaaaaaaaaaaaa

SEQ ID NO: 3359 - DNA, 876 bp, Populus trichocarpa
  Predicted polypeptide sequence is orthologous to G1798
ttttttttttttttttttggcacagagaaagtctaatgatatgcaataaatatatgtatcagtttacaattttagttaatctccttcatggtaggctggtagcttttttaacagacagcatataaattgctcttagaataataatattgccgtggttgttgcttgcgcaaatgcaatacagttaaagtctaagaatatttatgaatatgagaaggttggtctcacaataagagatggcgttcaccactagtttcttagagggaggcgccttgttcttgtttctggtagtccaatgaacaattcggtctccacatccgaaattgaactgctatctctctgttcttcacagggtaaattctctctctgttcccttgagagtactcgccatggctggacgccagacttgttagacagccttgcattttcagctgtcagttgcttctccttttgttttagttgctcaatctgttctctgaaaacctgattctttctagctcggatggtgcttacactcctctctaactgttgttcgatttgttgcagttcttcaacagtgcacgatcccaaacattctcccagtagctttctgaagcattttaaaattaattttcaaacatttacgtataatatttaattccaacagtcaatcaattcatcaaactatactataagcacaaaaggtttaaactaatcctttgaaccgtttcgaaacttcaagaatctctatcttctttatcatgctagctgcttcgcccttcagttgctccatgttcagttcgcttgtctgcttgtttgtgttgctttctttcacatgcctctgataacgttcaattgtctcctgcacgcttgagcttccaattcatagagcttccctct

SEQ ID NO: 3360 - DNA, 843 bp, Populus trichocarpa
  Predicted polypeptide sequence is orthologous to G1798
ttttttttttttttttttgccctattaaaagagactagactacaccaaaaccaaaaccctgattacaaaccaccaaaaaccaaaattataagcattagaatgaactaaaatgaaaacaagcacaactcatgagtttataaaagaatagggctcaaggctcaaggctcaaggctgctcaaatacatatatattaaaaaatatcacttctaatataatagtatttgagctgctatccaatacccctaccattgcaagtcctatttgctctctgacaataccctttatcgcttccaacaacatctggatcaccatctctcaaagcaaatctttattttcaaaatttgcatgaattgcctaagagccgagcactgatgttcatcataggtgcctaatagtaatagcacctaaacttccttcgccaaaccacgtgcattgttggaagtatccacttatgatgcatggtctccttcatggcccttctcattgttgatcttctcacataatgcttgaactatcacttcaagcgaactcttgtcatgttctagttgtgcattcttctcttgaagctggagtttatccaaattgttttggtcattaacttgactccttaacagaacaattttacttttgagctgtgtattttcacgctgaagatcagtatcgttggcaccagctagtcgctttgaaagaacctccacaacagtattttgtttatcatgcttctccttcagtagaacaattgttttcctgagtcgcttcatctcttgttcttgagattgcaaagtttgtctagtccgaactgcttctgttttaaaggaggcattctctccttttaatcgatcg

SEQ ID NO: 3361 - DNA, 514 bp, Populus trichocarpa
  Predicted polypeptide sequence is orthologous to G1911
gaatctcttcatggcttcaggttctagtaattggacttcaaagcaaaacaaactgttcgaaaatgccttggccatctatgatcaagaatctcctgatcgctggcacaatcttgccagggctgttggaaaaacagtggaggaagtgaagaagcattatcagatgcttgttgaagacgtccagcagattgaagctggtgaaatccctttgcccaactacactagaagatctggagctagcaacaagagctaccattgcaatgatgatcaagcacaaagggtgaagaatcttaatctcaactgaaggatacatgaactaagctagctatagaataaagatccattgcgctacaaatgacaataggcagaagcagcagcagtagcagcagtgttattagctagcaccgaaaatgggattacgatctctctttgttttatctgtttaattactttctcatcaaacattaattctcagttaatatctcttaatttcctgcttgcaaaaaaaaaaaaaaaa

SEQ ID NO: 3362 - DNA, 589 bp, Populus trichocarpa
  Predicted polypeptide sequence is orthologous to G1944
tcgtctcgagaaaggtttttctcaggaaacaaacagttccttctctttcttttcttgttcttttgttctttagtgttttgctgagagaaaactcgaaagtgccggtactatttgaagaaactaagcgaatgtgaaagggaccgagagagagacgctacagtttctggagagtatcttcttaaagtctcgaagttgctgttaatctggaaaatagtattgttaggtgtagtgatttttgaataatttacagtttatgcatggagggaagagaaggattgagttcaggggtaacagtgataggagcagaagctccatcaacctatcatatggcgccaaggacagaaaatcctggccagattgtagtgtcaccaccagccgtagaggtgccaccagttggtgcaggattgatcggaggaactgcagaaaagaagaaaagagggaggccaaggaaatatggaccggatggggcggtcgctagggcattatcaccgatgccaatttctgcttcggccccgcatactggtggagactactctgctggaaagccggggaaagtgtggcctggtagttatgaaaaaaaaaaaaaaaa

SEQ ID NO: 3363 - DNA, 925 bp, Populus trichocarpa
  Predicted polypeptide sequence is orthologous to G2226
ttttttttttttttttttgggtggagatcaaagcaagatagataggttaaacatcacttcttcacaatatgtacaataaaatttttggtctctcaaggacccatcagcacatcatgcttgatctcaagcacaaagtatacaccactatgccctgcccgatgcactcacgtaaatacatgtacacgctgtacaaggagaattcctctgacaaagcatacatggtagtatgcgctcaccaaaagcaagatgcatcctcttcaggcagcaatggagtcctgcaaagagggcatgtaatgttccaatagtccaaccacttctccaagcacattttatgaaagatatggccacatgacaggctatttatctccgattctggctcaaattgggtcaagcaaaccgagcagtcatgttcaggctgtttacagctgcacaccgtgttgaatcggattgatggcatcctgcttcggaactcctcaatgtaattctctgggggacttaaacgaaattcaaacgactctctggtgtcttcagcattatctgacgatgggagtgaagcagatggtgacaaacggatgccaacaatgtgaaggattgaacggactatccctttgacaatggaaattgacaaggcagtgtttactaaaagcacacatagtactccttcagatggagctggcagacttgatagacccattgaagtttcgtgggacttggttttttttgcagtgattccgcaaagctcaagctaacaagagattcttgattcacagtgtgctcaaatggaagttatggaagccaatggggggatacttatataaatcacagttgaagcgaatggagaaaaccggatgattccttcttttcttgatcttggggcatataaacagggtttttgactatgatgaaatgatgagtagcaaaatcc

SEQ ID NO: 3364 - DNA, 908 bp, Populus trichocarpa
  Predicted polypeptide sequence is orthologous to G2520
gaaaagaagaagaagcgaaggtagataggctggagagagagagagagagagtgagtataaagaaaggaaaggttatactctaaaaggctggaggcttcgagaatagctcatgactactgaagtgacacgctcactccgtccactgtaaggaagtgaagactatttagttacaactcccgaggaagtgagagaggtagcacactgcgcaccaccctccactgtctaaggagatcacagaccaaatcatcactttgtctctctctcgttctctttccccgtctactggtattgggattttaataatattaaaatggatccgcctgcaaggatgaatgaaggagggccttacagtttggaggagatctggcaatttcccattaacgggagcggaagagggcactttgatttacttaatttggagcagagagcagctgcttctgtcaggaaacgtcgcgatgttgatttggatgttgatgatgattcttcttcaaaacccactaccaacggacttctggacttagctgttcctattttttacctttgaactgaattgggagcattgtgatggtaagcggcttaaaacatcagggagtaaagatgaggatcaccatcgtcatcatgattctaaagatgaagcagaacccagttcaggcaagcatgtggaacacaaaactcaaccaccagagccatcaaaacaagattatatccacgtacgagcaagaaggggtcaagctactgatagccacagtctagctgaaagagctaggagagaaaagataagcgaaaggatgaaaattcttcaggatctagtcccaggctgtaacaaggttattgggcaggcccctggtccttgacgagattatcaattacatccaatcattacaacgtcaggttgagtttctatcaat

SEQ ID NO: 3365 - DNA, 825 bp, Populus trichocarpa
  Predicted polypeptide sequence is orthologous to G2520
ttttttttttttttttttcggataatatttaatgtcttgtatatgaaatattacaagttaatacaacaactttgtatatgaagtttaacacagagctacctgctatttacattatttactttgcatcaatggaatatgatttttgtaacctgctatttcaaccataaaaatgatcttttagattcactattagggaacaaacaaagaactatgcagtaatttttctttctttccctttgaagactcgaaaccctttctagtttgcattctcagtctttttcatcatctttcagttatcgtacaaaggtccacagcaggaaagtacctgctttattctggaacagattcttgatttgaaaaggcttcagctcactgatgtcaacaacaatactcctatgaaacgtggtcaagaacaaaaaaacatttcttcaatgctgaatacctcaaagaagcttgactacaatctcaatcattcacaacattctcaagatcttgttaccattcttcaacaagctgactgccaacgtcagggtctaaaagtggattctttgcctttgccattttctcagccagaacatttacctttcttttcaactgccgcaaatgctttgcctggagaatcctggtgtagatcttttgcctccaagcttaacatctctcatcttggtcttgaatgggatttaatttagaactatgccgatgaagtttttgaaaatctccactgcaaacgttattccaggacggacgaggttagctgttgataatgttgggcatggacatctataatatttgcaaaacaagtttccctgtggccctgtgggctcg

SEQ ID NO: 3366 - DNA, 906 bp, Populus trichocarpa
  Predicted polypeptide sequence is orthologous to G2741
ttttttttttttttttttcgaaataagctctttcagattaagggtcatgacaatggaagtattaagtagtcatgaaagagcctgaatttttttattttttttgttaaagtgatgctaacatgcacatggaccatcaatatacgactgtcactcccccggttataacaagtattatcagccaaggggtttgtggatgcacgaactgtaagcataatgttttgtcattatcatcttaaggaagtctttgtgcaggcttgatagtggaagacattggagaggatggatgcactaacctcttttttctcttcctctatagcatgccaaaaaaatatctcctcccaacatcacatgttgtcattaggtgcaacttgatgtggatgatgcgtgtatgaaccataatgattcccattccaatccctctgctgaaacatatgaccatgaacaacatttccattatacccgttttgatgaccattaatactaacttggtgatgctggtggttatcactactattattattttgaccgttgttattccccatttgcatccccatatgtccatatactggcattggcatcatcccacccgccgtggcagggtgatgataaggcatcggaattgggattccaaaattcccatttccgccgccgccgccatcactactctcgggaaaactctgcggcaaaggagtggacgcaaacaactgatcagaagcagaaggtccttcactcgacaacccctgcatcctcttcaaataaagccggtacttctgcaaatgactggctacattctcgcgagtcaaaccttcaacattcatcaactgcataatcgttttcggaaccgcgtttttaatccctaagtggctgaccacgtcaacaaacctcttatgcaactgaggggtccac

SEQ ID NO: 3367 - DNA, 744 bp, Populus trichocarpa
  Predicted polypeptide sequence is orthologous to G2747
ttttttttttttttttttggacttttaattaatatattatatagcaataagttaagtcactactaaaggaaaaacaatgatggaaatattcctgatatttatctgtatatatgtattatacacagttgaaggatttgtcgaactccacatttcttgcacctctcttccatctcttgctcttcacaatatacccaaaaccgcgtctattaatctaccgacaatatttaaacaatcgacaaaaagaaactcaaagaaggctaaaacttataaattgctagaaacgaaagaaatgggatcttcatcacttgatgtgcaggtgtgatcaaagatccaaatcaaaagataaggaagcctttcctttctttgaaaactcagcttgcattggagcaccagtgggttcccttacttggaaaggaggagggagagaagaggaagccaaacgaggggagagtgaatccaatgtgccatgtctgatcattgtaaccgaagatgacgggtcattttgtgtaggacactccatgtttacaccaaacagcctgagccgcttccccacagtcttaccatgaacaactggcactgagtctatcaccacctggcacatgacttcctccttgttcatgcactgccccaattggaagtgtactcgccggcggccttaagtaatactgcgctgcattgccataactaatgttggacggttgatgataatgatacagaagattatggtgttgatgttgttgataa

SEQ ID NO: 3368 - DNA, 913 bp, Populus trichocarpa
  Predicted polypeptide sequence is orthologous to G2763
ttttttttttttttttttggggaaggattttaattaacaactttattattaattaattaattaattaattaacagtttttctaggattcataacagagaaaatagaataccttttttcttaaagaaaaaaaaaacagagacacgtatttaacaggagtcaaaagaaaaaaaaatgtgggaaaaaaccagaaaacgacatctggcaacacaatcccattaggaggtcatcggctcagaagtagagctggcttcggaggtagagcgagaaagaagctcagctatagcagtcatggttttaacttgcatctccaaagcagcaatataatctgtagcttcttccaaaataacaggcaatggttgtttcaggcaaccaggaactaaccggccaagaacacgaactttcctttgaacagccggcaaacccttcgctttcaacctcaaaacactcactttatgcttcctcgacgaccggctgctactcccggtagtggatcctggagaagaagaagacgacgacgcaagtctctgtctcttatgttgttgtttccgaaatttgagtttgatgcggctagttaaaatggctcggctccacctggttttacctttagcagcgaaagctaaagcccgatcagcaacttctctaacggctcgaccttgacgcggggctgatgaagttgaagggttgagattgacttggcttaaggcttggatgagtttggatgagtagacttgttgttgtgcttctgttttccatttggcgtggctctgtgagttttggttctgttttgattggtgttgctgcaacactgatttcttcttctttttccttcttgttcgatccgtggtgatgtttggcgtagtactcactattgctgctgctactgctgacgacgacgatgggtccatcttcaat

SEQ ID NO: 3369 - DNA, 909 bp, Populus trichocarpa
  Predicted polypeptide sequence is orthologous to G2763
ttttttttttttttttttcttttttttttgaattctaatgccctagctagttcttataatcaattaacatttcttgaggattcaaaacaaagaaattagaacactgtttttttccacaaaaaaaagaagaagaggaaagacgagtatctaacggagctagaagaaaaaatatatatgggaaaaaaacagaacacgacatctgtcattacaagcctatcaggagctcatcggctccaaggaagagccggctccggaggaagagcgagaaagcagctcagctatagcagacatggctttaacttgcatctccagagcagcaatgtaatctgtagcttcttccaagataataggcaatggttgtttccggcaaccgggaactaatcggccaagaacacgaacttttctttgaacagccggcaaacccttccccttcagcctcaaaacactcactttatgcttcctcgacgaccggctattactcgcagttgtaacaacagtagatcctgaagaagacgaagacgcaagtctctgtcgcttatgttgctgtttccgaaatttgagtttgatccggtttgtcagaatggcccggctccatctggttttacctttagcagcaaaagctaaagctcgatcagcaacctctctaacggctcgaccttgacgtggggctgatgaagatgaggggttgagattgacttggcttaaggcttggataagtttggatgagtagatttgttgttgtgcttctgttttccatttggcgtggctctgggagttttggttctgttttgattggtgctgttgcaagagggatttcttcttctttttccttcttgttcgatccgtgttgatgttggcgttcgtattcactgctgctactgacgttgttgttgatgatgccatcatcat

SEQ ID NO: 3370 - DNA, 886 bp, Populus trichocarpa
  Predicted polypeptide sequence is orthologous to G2859
ttttttttttttttttttggatcaaatggatgcttaactgctcatgccgacaaagcagcatcaatacataggatgttaaacaccacaaatcactatagaaggtcaaatttgaaaaaagagagaaagaaattagccctcgaattggacaagtaaatagcaatataatctctctttttttgtactttatttctggacctttttgtgaagtaatgcaaatatcattagcatttctgccacataaatagacatttgatttgcggcaaagggtgatagctagggaacatattcttgtgctttatagcaacaaagagtaattgccaaaaatgcagtcaaatggaccatgtagagtggaagcaagtgatttctccatatctttctcttgaccatttctgtgtctcctgtgcgtcatcagttgaatttgttccctgagccttcttggaagattctgtgagatttttcaggtcattagaacaactggcagcggcaagctccatggagagaaactcaacttgattctgcaatgagtgtacataattgattatctcctctagcataactgccatccccattgacttgtggcatccaggaacaatgtcttgcaagcatcttaatttgttattgattttctctcttcttatcctttctgctatactgtgactgtctgttgcctggcctctcttagctctaacatgaataacttcctttgatttgtccccttctttctccttgtttttgcctttcttacctcttcctaagttattctttttctctgtgatgtttatagaggctgtaggagaaacgttcttggagctgccggttgattgttccattgcttttggcttcttcctttcatggaaaacattttgattcaagctgacagaatgaa

SEQ ID NO: 3371 - DNA, 874 bp, Populus trichocarpa
  Predicted polypeptide sequence is orthologous to G2990
gtgcagaatttgcaatatactaaaaaactaatctcaattttttatacaaacaaggggataccaaaagtcgagaagggggtaccaaactcgagctatatatttagtccatcgtatgccaaaatttggtgataactttggaaactctaattagtctttaaaaaggaaggcgaaacttcaaaataagtcggttttggggttgaggggtaaccaacagactggattaattcctccacagtcagcacatgaaactttggaggtgaattaagagcaatgttgtcgacccgatgctgaaagatcttccccttgctgtcaagtttgtactcagacaggccatcacctcgtgccgaattcggcacgagggagcagtgcccttggcctttgccttgcacagttgtatccctctaatctatatctaccatcttatctcccacctcccaaaccccatttcccattacctcgtgagacattttggctttctaaacagataaatatcatcatcactgtattcccatcaacttcttcatccttcgtgtgtaaaaattgctctcaattctctacatgactaaaaaagccatggactcaaccacaagcccccaccacatcaccaaatcccctgactcggacacagatactgaaaccccactccaaacccatctcaccaaggccttatcccttacaaatggctcacacaagacccaccaaaatcgccatcttccaccaccaccacaacagcaaaatatggtggtgtcttacaaagaatgccacaaaaaccatgctgcaggtattggtggactagccttggatggctgtggggagtttatgcccaagtcaactgccacccctcaagaccctacctcgttcaaatgtgctgcct

SEQ ID NO: 3372 - DNA, 815 bp, Populus trichocarpa
  Predicted polypeptide sequence is orthologous to G3032
ttttttttttttttttttacaaactcccacacacatcactttttactatgtttactcacccataattacatgtttacaaaataacataaattaaaaaaaaaactaacaataatttagatacatattccaacatgtaaaaaaaattacaaaacagacccctaaaaatccaagaattgtagaggaggacttctaggaatataggaacagtggcggcgcgtcttctccacgcgtcgccgctgctgccgcaagcgaagcctaaaagatcggtggatctaggatgttttctcctcctctccctttctgcaccggcgatgataaccaccatcacctacaaaagaagaaaaaaaacacaagtttcggttcttcctccctttttttagatctgctctcttttggcttcactctttcttgtggttcgttgttttttttttgtcttctgcaggtgatagatctggcggttgggtagctacaaggctagctctgggctactgttttggtcgttactgttgaggagactagaggagggtgatggctttgttgtggctgatggtgaaggaaatggcggggatctatgggctgctagatctctggtgaagactgtgctcctgcggctaatgagggagatcgtgggtctgtggccgctgaaactgtggtggagatgggagtggctgtctggtcggtttcgggttggtcaggagagaacagggaaaatggggatgagatgcaaacactgggaaggaacggctaagagagggagatctggtgagggactgtctaggctgaaaggggaggcttcttcgggtgtaggggaagaa
